United States Patent 12,097,253 (RSV RNA MOLECULES AND COMPOSITIONS FOR VACCINATION) - sequence listing, part 12

SEQ ID NO: 16463 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16464 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16465 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16466 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16467 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16468 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16469 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16470 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16471 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16472 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16473 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16474 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut4 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16475 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16476 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16477 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16478 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16479 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16480 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16481 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16482 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut4 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16483 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16484 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16485 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16486 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16487 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16488 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16489 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16490 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut4 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16491 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16492 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16493 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16494 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16495 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16496 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16497 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16498 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut4 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16499 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16500 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16501 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt2)
  source 1..1994: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16502 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt3)
  source 1..1994: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16503 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt4)
  source 1..1994: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16504 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt5)
  source 1..1994: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16505 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt6)
  source 1..1994: mol_type = other RNA
gggagaggcgctgcctacggaggtggcagccatctccttctcggcatcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16506 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut4 (opt11)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16507 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16508 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16509 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt2)
  source 1..1990: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16510 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt3)
  source 1..1990: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16511 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt4)
  source 1..1990: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16512 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt5)
  source 1..1990: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16513 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt6)
  source 1..1990: mol_type = other RNA
ggggcgctgcctacggaggtggcagccatctccttctcggcatcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16514 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut4 (opt11)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16515 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16516 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16517 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt2)
  source 1..1825: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16518 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt3)
  source 1..1825: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16519 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt4)
  source 1..1825: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16520 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt5)
  source 1..1825: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16521 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt6)
  source 1..1825: mol_type = other RNA
gggagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16522 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut4 (opt11)
  source 1..1825: mol_type = other RNA
gggagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16523 - protein, 514 aa, synthetic construct
  REGION 1..514: note = derived and/or modified protein sequence (artificial) from HRSV(Memphis-37)__AIY60640.1__F-del_DSCav1_mut4
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAAGSGSAICSGIAVCKVLHLEGEVNKIKNALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNIDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 16524 - RNA, 1545 nt, synthetic construct
  misc_feature 1..1545: note = derived and/or modified CDS sequence (opt1) from HRSV(Memphis-37)__AIY60640.1__F-del_DSCav1_mut4
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 16525 - RNA, 1545 nt, synthetic construct
  misc_feature 1..1545: note = derived and/or modified CDS sequence (opt1) from HRSV(Memphis-37)__AIY60640.1__F-del_DSCav1_mut4
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtga

SEQ ID NO: 16526 - RNA, 1545 nt, synthetic construct
  misc_feature 1..1545: note = derived and/or modified CDS sequence (opt2) from HRSV(Memphis-37)__AIY60640.1__F-del_DSCav1_mut4
  source 1..1545: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 16527 - RNA, 1545 nt, synthetic construct
  misc_feature 1..1545: note = derived and/or modified CDS sequence (opt3) from HRSV(Memphis-37)__AIY60640.1__F-del_DSCav1_mut4
  source 1..1545: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctga

SEQ ID NO: 16528 - RNA, 1545 nt, synthetic construct
  misc_feature 1..1545: note = derived and/or modified CDS sequence (opt4) from HRSV(Memphis-37)__AIY60640.1__F-del_DSCav1_mut4
  source 1..1545: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 16529 - RNA, 1545 nt, synthetic construct
  misc_feature 1..1545: note = derived and/or modified CDS sequence (opt5) from HRSV(Memphis-37)__AIY60640.1__F-del_DSCav1_mut4
  source 1..1545: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatga

SEQ ID NO: 16530 - RNA, 1545 nt, synthetic construct
  misc_feature 1..1545: note = derived and/or modified CDS sequence (opt6) from HRSV(Memphis-37)__AIY60640.1__F-del_DSCav1_mut4
  source 1..1545: mol_type = other RNA
atggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatag

SEQ ID NO: 16531 - RNA, 1545 nt, synthetic construct
  misc_feature 1..1545: note = derived and/or modified CDS sequence (opt11) from HRSV(Memphis-37)__AIY60640.1__F-del_DSCav1_mut4
  source 1..1545: mol_type = other RNA
atggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaa

SEQ ID NO: 16532 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16533 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16534 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt2)
  source 1..1821: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16535 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt3)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16536 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt4)
  source 1..1821: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16537 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt5)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16538 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt6)
  source 1..1821: mol_type = other RNA
gggagagtcccgcagtcggcgtccagcggctctgcttgttcgtgtgtgtgtcgttgcaggccttattcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16539 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut4 (opt11)
  source 1..1821: mol_type = other RNA
gggagagtcccgcagtcggcgtccagcggctctgcttgttcgtgtgtgtgtcgttgcaggccttattcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16540 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16541 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16542 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16543 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16544 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16545 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16546 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16547 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut4 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16548 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16549 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16550 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16551 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16552 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16553 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16554 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16555 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut4 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16556 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16557 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16558 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16559 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16560 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16561 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16562 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16563 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut4 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16564 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16565 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16566 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt2)
  source 1..1813: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16567 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt3)
  source 1..1813: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16568 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt4)
  source 1..1813: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16569 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt5)
  source 1..1813: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16570 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt6)
  source 1..1813: mol_type = other RNA
gggagactttcccattctgtagcagaatttggtgttgcctgtggtcttggtcccgcggagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16571 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut4 (opt11)
  source 1..1813: mol_type = other RNA
gggagactttcccattctgtagcagaatttggtgttgcctgtggtcttggtcccgcggagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16572 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16573 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16574 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16575 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16576 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16577 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16578 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16579 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut4 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16580 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16581 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16582 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt2)
  source 1..1814: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16583 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt3)
  source 1..1814: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16584 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt4)
  source 1..1814: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16585 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt5)
  source 1..1814: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16586 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt6)
  source 1..1814: mol_type = other RNA
gggagagcctctgctggagtccggggagtggcgttggctgctagagcgaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16587 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut4 (opt11)
  source 1..1814: mol_type = other RNA
gggagagcctctgctggagtccggggagtggcgttggctgctagagcgaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16588 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16589 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16590 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt2)
  source 1..1834: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16591 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt3)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16592 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt4)
  source 1..1834: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16593 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt5)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16594 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt6)
  source 1..1834: mol_type = other RNA
gggagagtcccgcagtcggcgtccagcggctctgcttgttcgtgtgtgtgtcgttgcaggccttattcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16595 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut4 (opt11)
  source 1..1834: mol_type = other RNA
gggagagtcccgcagtcggcgtccagcggctctgcttgttcgtgtgtgtgtcgttgcaggccttattcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16596 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16597 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16598 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt2)
  source 1..1885: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16599 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt3)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16600 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt4)
  source 1..1885: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16601 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt5)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16602 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt6)
  source 1..1885: mol_type = other RNA
gggagagtcccgcagtcggcgtccagcggctctgcttgttcgtgtgtgtgtcgttgcaggccttattcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16603 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut4 (opt11)
  source 1..1885: mol_type = other RNA
gggagagtcccgcagtcggcgtccagcggctctgcttgttcgtgtgtgtgtcgttgcaggccttattcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16604 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16605 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16606 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16607 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16608 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16609 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16610 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16611 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut4 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16612 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16613 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16614 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16615 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16616 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16617 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16618 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16619 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut4 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16620 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16621 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16622 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16623 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16624 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16625 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16626 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16627 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut4 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16628 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16629 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16630 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16631 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16632 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16633 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16634 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16635 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut4 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16636 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16637 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16638 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16639 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16640 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16641 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16642 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16643 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut4 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16644 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16645 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16646 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt2)
  source 1..1834: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16647 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt3)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16648 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt4)
  source 1..1834: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16649 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt5)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16650 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt6)
  source 1..1834: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16651 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut4 (opt11)
  source 1..1834: mol_type = other RNA
gggagagcggctcggccattttgtcccagtcagtccggaggctgcggctgcagaagtaccgcctgcggagtaactgcaaagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16652 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16653 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16654 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16655 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16656 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16657 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16658 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16659 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut4 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16660 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16661 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16662 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt2)
  source 1..1898: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16663 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt3)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16664 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt4)
  source 1..1898: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16665 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt5)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16666 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt6)
  source 1..1898: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16667 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut4 (opt11)
  source 1..1898: mol_type = other RNA
gggagagcggctcggccattttgtcccagtcagtccggaggctgcggctgcagaagtaccgcctgcggagtaactgcaaagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16668 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16669 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16670 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16671 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16672 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16673 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16674 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16675 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut4 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16676 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16677 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16678 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16679 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16680 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16681 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16682 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt6)
  source 1..1897: mol_type = other RNA
gggagagtcccgcagtcggcgtccagcggctctgcttgttcgtgtgtgtgtcgttgcaggccttattcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16683 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut4 (opt11)
  source 1..1897: mol_type = other RNA
gggagagtcccgcagtcggcgtccagcggctctgcttgttcgtgtgtgtgtcgttgcaggccttattcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16684 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16685 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16686 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16687 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16688 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16689 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16690 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16691 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut4 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16692 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16693 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16694 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16695 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16696 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16697 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16698 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16699 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut4 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16700 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16701 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16702 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16703 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16704 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16705 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16706 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16707 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut4 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16708 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16709 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16710 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt2)
  source 1..1826: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16711 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt3)
  source 1..1826: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16712 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt4)
  source 1..1826: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16713 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt5)
  source 1..1826: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16714 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt6)
  source 1..1826: mol_type = other RNA
gggagactttcccattctgtagcagaatttggtgttgcctgtggtcttggtcccgcggagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16715 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut4 (opt11)
  source 1..1826: mol_type = other RNA
gggagactttcccattctgtagcagaatttggtgttgcctgtggtcttggtcccgcggagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16716 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16717 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16718 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16719 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16720 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16721 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16722 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16723 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut4 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16724 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16725 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16726 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt2)
  source 1..1847: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16727 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt3)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16728 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt4)
  source 1..1847: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16729 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt5)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16730 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt6)
  source 1..1847: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16731 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut4 (opt11)
  source 1..1847: mol_type = other RNA
gggagagcggctcggccattttgtcccagtcagtccggaggctgcggctgcagaagtaccgcctgcggagtaactgcaaagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16732 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16733 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16734 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt2)
  source 1..1914: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16735 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt3)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16736 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt4)
  source 1..1914: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16737 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt5)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16738 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt6)
  source 1..1914: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16739 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut4 (opt11)
  source 1..1914: mol_type = other RNA
gggagagcggctcggccattttgtcccagtcagtccggaggctgcggctgcagaagtaccgcctgcggagtaactgcaaagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16740 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16741 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16742 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt2)
  source 1..2130: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16743 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt3)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16744 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt4)
  source 1..2130: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16745 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt5)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16746 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt6)
  source 1..2130: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16747 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut4 (opt11)
  source 1..2130: mol_type = other RNA
gggagagcggctcggccattttgtcccagtcagtccggaggctgcggctgcagaagtaccgcctgcggagtaactgcaaagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16748 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16749 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16750 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16751 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16752 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16753 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16754 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt6)
  source 1..1910: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16755 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut4 (opt11)
  source 1..1910: mol_type = other RNA
gggagagcggctcggccattttgtcccagtcagtccggaggctgcggctgcagaagtaccgcctgcggagtaactgcaaagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16756 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16757 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16758 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt2)
  source 1..1901: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16759 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt3)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16760 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt4)
  source 1..1901: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16761 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt5)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16762 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt6)
  source 1..1901: mol_type = other RNA
gggagagtcccgcagtcggcgtccagcggctctgcttgttcgtgtgtgtgtcgttgcaggccttattcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16763 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut4 (opt11)
  source 1..1901: mol_type = other RNA
gggagagtcccgcagtcggcgtccagcggctctgcttgttcgtgtgtgtgtcgttgcaggccttattcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16764 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16765 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16766 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt2)
  source 1..2117: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16767 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt3)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16768 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt4)
  source 1..2117: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16769 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt5)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16770 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt6)
  source 1..2117: mol_type = other RNA
gggagagtcccgcagtcggcgtccagcggctctgcttgttcgtgtgtgtgtcgttgcaggccttattcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16771 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut4 (opt11)
  source 1..2117: mol_type = other RNA
gggagagtcccgcagtcggcgtccagcggctctgcttgttcgtgtgtgtgtcgttgcaggccttattcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16772 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16773 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16774 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt2)
  source 1..1893: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16775 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt3)
  source 1..1893: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16776 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt4)
  source 1..1893: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16777 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt5)
  source 1..1893: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16778 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt6)
  source 1..1893: mol_type = other RNA
gggagactttcccattctgtagcagaatttggtgttgcctgtggtcttggtcccgcggagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16779 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut4 (opt11)
  source 1..1893: mol_type = other RNA
gggagactttcccattctgtagcagaatttggtgttgcctgtggtcttggtcccgcggagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16780 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16781 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16782 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16783 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16784 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16785 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16786 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt6)
  source 1..1889: mol_type = other RNA
gggagactttcccattctgtagcagaatttggtgttgcctgtggtcttggtcccgcggagaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16787 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut4 (opt11)
  source 1..1889: mol_type = other RNA
gggagactttcccattctgtagcagaatttggtgttgcctgtggtcttggtcccgcggagaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16788 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16789 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16790 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16791 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16792 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16793 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16794 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16795 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut4 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16796 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16797 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16798 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16799 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16800 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16801 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16802 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16803 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut4 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16804 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16805 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16806 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16807 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16808 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16809 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16810 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16811 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut4 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16812 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16813 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16814 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16815 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16816 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16817 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16818 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16819 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut4 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16820 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16821 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16822 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16823 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16824 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16825 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16826 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16827 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut4 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16828 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16829 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16830 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16831 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16832 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16833 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16834 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16835 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut4 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16836 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16837 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16838 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16839 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16840 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16841 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16842 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16843 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut4 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16844 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16845 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16846 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16847 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16848 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16849 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16850 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16851 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut4 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16852 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16853 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16854 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16855 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16856 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16857 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16858 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16859 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut4 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16860 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16861 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16862 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16863 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16864 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16865 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16866 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16867 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut4 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16868 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16869 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16870 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt2)
  source 1..1931: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16871 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt3)
  source 1..1931: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16872 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt4)
  source 1..1931: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16873 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt5)
  source 1..1931: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16874 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt6)
  source 1..1931: mol_type = other RNA
gggagaggcgctgcctacggaggtggcagccatctccttctcggcatcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16875 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut4 (opt11)
  source 1..1931: mol_type = other RNA
gggagaggcgctgcctacggaggtggcagccatctccttctcggcatcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16876 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16877 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16878 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt2)
  source 1..1927: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16879 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt3)
  source 1..1927: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16880 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt4)
  source 1..1927: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16881 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt5)
  source 1..1927: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16882 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt6)
  source 1..1927: mol_type = other RNA
ggggcgctgcctacggaggtggcagccatctccttctcggcatcaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16883 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut4 (opt11)
  source 1..1927: mol_type = other RNA
ggggcgctgcctacggaggtggcagccatctccttctcggcatcaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16884 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16885 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16886 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt2)
  source 1..1762: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16887 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt3)
  source 1..1762: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16888 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt4)
  source 1..1762: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16889 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt5)
  source 1..1762: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16890 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt6)
  source 1..1762: mol_type = other RNA
gggagaaagcttaccatggaactaccaatactcaaaacaaacgcaataacaactatactagccgcagttacactctgcttcgcttcatcacaaaatatcacagaagaattttaccaatctacatgttcagctgtatccaaaggttacctttcagcactacgaacaggatggtatacctcagtaatcaccatcgaactctcgaacataaaagaaaacaaatgtaacggaaccgatgctaaagtcaagctcataaaacaagaactagacaaatacaaaaacgcagtaaccgaactacaactacttatgcaatcaacaccagctgcaggctcaggctcagcaatctgctcaggcatagctgtatgcaaagtactacatctagaaggagaagtaaacaaaataaaaaacgcattattatcaacaaataaagcagtagtatcactatcaaatggagtatcagtactcacattcaaagtactagatctaaaaaactacattgacaaacaattactaccaatcctcaacaaacaatcatgctcaatatccaacatagaaacagtaatagaatttcaacaaaaaaacaatcgactactagaaataacaagagaattttcagtcaatgccggagttacaacacccgtaagcacttacatgctaaccaactcagaactactatcactaataaacgacatgccaattacaaacgaccaaaaaaaactaatgtcaaataacgtacaaatagtacgtcaacaatcatactcaataatgtgcataataaaagaagaagtcctagcatacgtagtacaattacccttatatggcgtaatagacacaccatgctggaaactacacacatccccactctgcaccaccaacaccaaagaaggctccaacatatgtctaacccgaaccgacagaggttggtattgtgataacgctggctccgtatcattcttcccacaagcagaaacatgtaaagtacaatcaaacagagtattctgcgatacaatgaatagcagaacactaccatcagaagtaaacttatgcaacatcgacatcttcaatcccaaatacgactgcaaaataatgacatccaaaactgacgtttcttcaagcgtaataacatctttaggagcaatagtatcctgctacggaaaaactaaatgcacagcatccaataaaaaccgtggaataataaaaacattctcaaatggctgcgactacgtctcaaacaaaggcgtagacaccgttagtgtcggaaacacactatattgcgtaaataaacaagaaggaaaatccttatacgtaaaaggcgaaccaataattaacttctatgaccccctcgtatttccatccgatgaatttgacgcatcaatctcgcaagtaaacgaaaaaataaaccaaagcctagcattcataagaaaatccgacgaactactccacaatgtaaatgtaggaaaatcaactaccaacataatgattactactataataatagtaattatagtcatcttactactattaatagcagtcggattattcctatactgcaaagcaagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16891 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut4 (opt11)
  source 1..1762: mol_type = other RNA
gggagaaagcttaccatggagctccccatcctaaaaaccaacgccatcaccaccatcctcgccgccgtcaccctatgcttcgcttcatcacaaaacatcaccgaagaattttaccaatctacctgctccgccgtctccaaaggatatctcagcgccctacggaccggctggtacacctccgtcataaccatcgaactcagtaacatcaaagaaaacaaatgcaacggcaccgacgccaaagtcaaactaatcaaacaagaactagataaatacaaaaacgcggtcaccgaactacaactcctaatgcaaagcacccccgccgccggatccggctccgccatatgctccggcattgctgtctgcaaagtactacacctcgagggcgaggtcaacaaaatcaaaaacgcactactcagcactaataaagccgtagtatccctatcaaacggtgtctcagtcttaacattcaaagtactcgacctaaagaactacatcgacaaacaactcctacccatcctcaacaagcagtcctgttctatctcaaacatcgaaaccgtcatcgaatttcaacaaaagaacaaccgcctcctcgaaatcacacgcgagttctccgtcaacgcaggagtaaccacccccgtctccacctacatgctcacaaactcggaactcctctcactaatcaacgacatgcccatcaccaacgaccaaaagaaactcatgagcaacaacgttcaaatcgtccgccaacaatcatactccatcatgtgcataatcaaagaagaagtcctagcttacgtcgtccagctgcccctctacggagtcatcgacacgccctgctggaaactacacacaagccccctctgcaccaccaacaccaaagaaggctccaacatatgcctcacacggaccgaccgcggttggtactgcgacaacgccggctccgtctccttcttcccccaagcagaaacttgcaaagtccaatccaaccgcgtattctgcgacacaatgaacagcagaacactccctagcgaagtcaacctctgcaacatcgacatattcaaccccaaatacgactgcaaaatcatgacgtcaaaaaccgacgtctccagctccgttatcacctcactcggcgccatcgtcagctgctacggcaaaactaaatgcaccgcctccaacaaaaaccgcggcatcattaaaaccttcagcaacggctgcgactacgtctccaacaaaggtgtcgatacggtatccgtcggaaacaccctatactgcgtcaacaaacaagaaggcaaatctctctacgtcaaaggcgaacccataatcaatttctacgaccccctagtcttcccctccgatgaatttgacgcctccatcagccaagtcaacgagaaaatcaaccaatcactagccttcatccggaaatccgacgaactcctacacaacgtaaacgtcggcaaatccaccaccaatataatgatcacaaccatcatcatcgtaatcatcgtcatcctcctcctactcatcgccgtcggattattcttatactgcaaagcccgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16892 - protein, 536 aa, synthetic construct
  REGION 1..536: note = derived and/or modified protein sequence (artificial) from HRSV(Memphis-37)__AIY60640.1__F_DSCav1_mut5
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAAGSGSAIASGIAVCKVLHLEGEVNKIKNALLSTNKAVVSLSGCGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNIDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 16893 - RNA, 1611 nt, synthetic construct
  misc_feature 1..1611: note = derived and/or modified CDS sequence (opt1) from HRSV(Memphis-37)__AIY60640.1__F_DSCav1_mut5
  source 1..1611: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 16894 - RNA, 1611 nt, synthetic construct
  misc_feature 1..1611: note = derived and/or modified CDS sequence (opt1) from HRSV(Memphis-37)__AIY60640.1__F_DSCav1_mut5
  source 1..1611: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactga

SEQ ID NO: 16895 - RNA, 1611 nt, synthetic construct
  misc_feature 1..1611: note = derived and/or modified CDS sequence (opt2) from HRSV(Memphis-37)__AIY60640.1__F_DSCav1_mut5
  source 1..1611: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 16896 - RNA, 1611 nt, synthetic construct
  misc_feature 1..1611: note = derived and/or modified CDS sequence (opt3) from HRSV(Memphis-37)__AIY60640.1__F_DSCav1_mut5
  source 1..1611: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattga

SEQ ID NO: 16897 - RNA, 1611 nt, synthetic construct
  misc_feature 1..1611: note = derived and/or modified CDS sequence (opt4) from HRSV(Memphis-37)__AIY60640.1__F_DSCav1_mut5
  source 1..1611: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 16898 - RNA, 1611 nt, synthetic construct
  misc_feature 1..1611: note = derived and/or modified CDS sequence (opt5) from HRSV(Memphis-37)__AIY60640.1__F_DSCav1_mut5
  source 1..1611: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattga

SEQ ID NO: 16899 - RNA, 1611 nt, synthetic construct
  misc_feature 1..1611: note = derived and/or modified CDS sequence (opt6) from HRSV(Memphis-37)__AIY60640.1__F_DSCav1_mut5
  source 1..1611: mol_type = other RNA
atggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaa

SEQ ID NO: 16900 - RNA, 1611 nt, synthetic construct
  misc_feature 1..1611: note = derived and/or modified CDS sequence (opt11) from HRSV(Memphis-37)__AIY60640.1__F_DSCav1_mut5
  source 1..1611: mol_type = other RNA
atggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactag

SEQ ID NO: 16901 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt1)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16902 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt1)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16903 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt2)
  source 1..1887: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16904 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt3)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16905 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt4)
  source 1..1887: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16906 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt5)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16907 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt6)
  source 1..1887: mol_type = other RNA
gggagagtcccgcagtcggcgtccagcggctctgcttgttcgtgtgtgtgtcgttgcaggccttattcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16908 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut5 (opt11)
  source 1..1887: mol_type = other RNA
gggagagtcccgcagtcggcgtccagcggctctgcttgttcgtgtgtgtgtcgttgcaggccttattcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16909 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16910 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16911 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt2)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16912 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt3)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16913 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt4)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16914 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt5)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16915 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt6)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16916 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut5 (opt11)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16917 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16918 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16919 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt2)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16920 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt3)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16921 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt4)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16922 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt5)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16923 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt6)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16924 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut5 (opt11)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16925 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16926 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16927 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt2)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16928 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt3)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16929 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt4)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16930 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt5)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16931 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt6)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16932 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut5 (opt11)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16933 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt1)
  source 1..1879: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16934 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt1)
  source 1..1879: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16935 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt2)
  source 1..1879: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16936 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt3)
  source 1..1879: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16937 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt4)
  source 1..1879: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16938 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt5)
  source 1..1879: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16939 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt6)
  source 1..1879: mol_type = other RNA
gggagactttcccattctgtagcagaatttggtgttgcctgtggtcttggtcccgcggagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16940 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut5 (opt11)
  source 1..1879: mol_type = other RNA
gggagactttcccattctgtagcagaatttggtgttgcctgtggtcttggtcccgcggagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16941 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16942 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16943 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt2)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16944 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt3)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16945 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt4)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16946 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt5)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16947 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt6)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16948 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut5 (opt11)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16949 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt1)
  source 1..1880: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16950 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt1)
  source 1..1880: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16951 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt2)
  source 1..1880: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16952 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt3)
  source 1..1880: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16953 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt4)
  source 1..1880: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16954 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt5)
  source 1..1880: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16955 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt6)
  source 1..1880: mol_type = other RNA
gggagagcctctgctggagtccggggagtggcgttggctgctagagcgaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16956 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut5 (opt11)
  source 1..1880: mol_type = other RNA
gggagagcctctgctggagtccggggagtggcgttggctgctagagcgaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16957 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16958 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16959 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt2)
  source 1..1900: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16960 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt3)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16961 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt4)
  source 1..1900: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16962 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt5)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16963 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt6)
  source 1..1900: mol_type = other RNA
gggagagtcccgcagtcggcgtccagcggctctgcttgttcgtgtgtgtgtcgttgcaggccttattcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16964 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut5 (opt11)
  source 1..1900: mol_type = other RNA
gggagagtcccgcagtcggcgtccagcggctctgcttgttcgtgtgtgtgtcgttgcaggccttattcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16965 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt1)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16966 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt1)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16967 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt2)
  source 1..1951: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16968 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt3)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16969 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt4)
  source 1..1951: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16970 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt5)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16971 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt6)
  source 1..1951: mol_type = other RNA
gggagagtcccgcagtcggcgtccagcggctctgcttgttcgtgtgtgtgtcgttgcaggccttattcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16972 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut5 (opt11)
  source 1..1951: mol_type = other RNA
gggagagtcccgcagtcggcgtccagcggctctgcttgttcgtgtgtgtgtcgttgcaggccttattcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16973 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16974 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16975 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt2)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16976 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt3)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16977 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt4)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16978 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt5)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16979 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt6)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16980 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut5 (opt11)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16981 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16982 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16983 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16984 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16985 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16986 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16987 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16988 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut5 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16989 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16990 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16991 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt2)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16992 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt3)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16993 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt4)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16994 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt5)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16995 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt6)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16996 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut5 (opt11)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16997 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16998 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16999 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt2)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17000 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt3)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17001 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt4)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17002 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt5)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17003 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt6)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17004 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut5 (opt11)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17005 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17006 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17007 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt2)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17008 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt3)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17009 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt4)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17010 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt5)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17011 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt6)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17012 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut5 (opt11)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17013 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt1)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17014 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt1)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17015 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt2)
  source 1..1900: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17016 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt3)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17017 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt4)
  source 1..1900: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17018 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt5)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17019 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt6)
  source 1..1900: mol_type = other RNA
gggagagcggctcggccattttgtcccagtcagtccggaggctgcggctgcagaagtaccgcctgcggagtaactgcaaagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17020 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut5 (opt11)
  source 1..1900: mol_type = other RNA
gggagagcggctcggccattttgtcccagtcagtccggaggctgcggctgcagaagtaccgcctgcggagtaactgcaaagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17021 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17022 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17023 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt2)
  source 1..1909: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17024 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt3)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17025 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt4)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17026 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt5)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17027 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt6)
  source 1..1909: mol_type = other RNA
gggagacccgtgacccggaagttgtacggctacgcgactttccctcccacaaaccctcgcgcccttcctttcctacttgggcccggcagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17028 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut5 (opt11)
  source 1..1909: mol_type = other RNA
gggagacccgtgacccggaagttgtacggctacgcgactttccctcccacaaaccctcgcgcccttcctttcctacttgggcccggcagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17029 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt1)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17030 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt1)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17031 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt2)
  source 1..1964: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17032 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt3)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17033 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt4)
  source 1..1964: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17034 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt5)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17035 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt6)
  source 1..1964: mol_type = other RNA
gggagagcggctcggccattttgtcccagtcagtccggaggctgcggctgcagaagtaccgcctgcggagtaactgcaaagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17036 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut5 (opt11)
  source 1..1964: mol_type = other RNA
gggagagcggctcggccattttgtcccagtcagtccggaggctgcggctgcagaagtaccgcctgcggagtaactgcaaagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17037 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17038 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17039 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt2)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17040 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt3)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17041 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt4)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17042 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt5)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17043 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt6)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17044 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut5 (opt11)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17045 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt1)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17046 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt1)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17047 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt2)
  source 1..1963: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17048 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt3)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17049 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt4)
  source 1..1963: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17050 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt5)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17051 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt6)
  source 1..1963: mol_type = other RNA
gggagagtcccgcagtcggcgtccagcggctctgcttgttcgtgtgtgtgtcgttgcaggccttattcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17052 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut5 (opt11)
  source 1..1963: mol_type = other RNA
gggagagtcccgcagtcggcgtccagcggctctgcttgttcgtgtgtgtgtcgttgcaggccttattcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17053 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17054 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17055 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt2)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17056 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt3)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17057 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt4)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17058 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt5)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17059 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt6)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17060 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut5 (opt11)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17061 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17062 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17063 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt2)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17064 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt3)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17065 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt4)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17066 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt5)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17067 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt6)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17068 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut5 (opt11)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17069 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17070 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17071 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17072 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17073 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17074 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17075 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17076 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut5 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17077 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17078 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17079 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt2)
  source 1..1892: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17080 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt3)
  source 1..1892: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17081 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt4)
  source 1..1892: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17082 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt5)
  source 1..1892: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17083 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt6)
  source 1..1892: mol_type = other RNA
gggagactttcccattctgtagcagaatttggtgttgcctgtggtcttggtcccgcggagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17084 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut5 (opt11)
  source 1..1892: mol_type = other RNA
gggagactttcccattctgtagcagaatttggtgttgcctgtggtcttggtcccgcggagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17085 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17086 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17087 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17088 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17089 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17090 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17091 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17092 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut5 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17093 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17094 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17095 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt2)
  source 1..1913: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17096 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt3)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17097 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt4)
  source 1..1913: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17098 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt5)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17099 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt6)
  source 1..1913: mol_type = other RNA
gggagagcggctcggccattttgtcccagtcagtccggaggctgcggctgcagaagtaccgcctgcggagtaactgcaaagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17100 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut5 (opt11)
  source 1..1913: mol_type = other RNA
gggagagcggctcggccattttgtcccagtcagtccggaggctgcggctgcagaagtaccgcctgcggagtaactgcaaagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17101 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt1)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17102 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt1)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17103 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt2)
  source 1..1980: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17104 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt3)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17105 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt4)
  source 1..1980: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17106 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt5)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17107 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt6)
  source 1..1980: mol_type = other RNA
gggagagcggctcggccattttgtcccagtcagtccggaggctgcggctgcagaagtaccgcctgcggagtaactgcaaagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17108 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut5 (opt11)
  source 1..1980: mol_type = other RNA
gggagagcggctcggccattttgtcccagtcagtccggaggctgcggctgcagaagtaccgcctgcggagtaactgcaaagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17109 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt1)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17110 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt1)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17111 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt2)
  source 1..2196: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17112 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt3)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17113 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt4)
  source 1..2196: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17114 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt5)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17115 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt6)
  source 1..2196: mol_type = other RNA
gggagagcggctcggccattttgtcccagtcagtccggaggctgcggctgcagaagtaccgcctgcggagtaactgcaaagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17116 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut5 (opt11)
  source 1..2196: mol_type = other RNA
gggagagcggctcggccattttgtcccagtcagtccggaggctgcggctgcagaagtaccgcctgcggagtaactgcaaagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17117 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt1)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17118 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt1)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17119 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt2)
  source 1..1976: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17120 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt3)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17121 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt4)
  source 1..1976: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17122 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt5)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17123 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt6)
  source 1..1976: mol_type = other RNA
gggagagcggctcggccattttgtcccagtcagtccggaggctgcggctgcagaagtaccgcctgcggagtaactgcaaagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17124 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut5 (opt11)
  source 1..1976: mol_type = other RNA
gggagagcggctcggccattttgtcccagtcagtccggaggctgcggctgcagaagtaccgcctgcggagtaactgcaaagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17125 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt1)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17126 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt1)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17127 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt2)
  source 1..1967: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17128 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt3)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17129 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt4)
  source 1..1967: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17130 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt5)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17131 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt6)
  source 1..1967: mol_type = other RNA
gggagagtcccgcagtcggcgtccagcggctctgcttgttcgtgtgtgtgtcgttgcaggccttattcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17132 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut5 (opt11)
  source 1..1967: mol_type = other RNA
gggagagtcccgcagtcggcgtccagcggctctgcttgttcgtgtgtgtgtcgttgcaggccttattcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17133 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt1)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17134 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt1)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17135 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt2)
  source 1..2183: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17136 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt3)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17137 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt4)
  source 1..2183: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17138 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt5)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17139 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt6)
  source 1..2183: mol_type = other RNA
gggagagtcccgcagtcggcgtccagcggctctgcttgttcgtgtgtgtgtcgttgcaggccttattcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17140 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut5 (opt11)
  source 1..2183: mol_type = other RNA
gggagagtcccgcagtcggcgtccagcggctctgcttgttcgtgtgtgtgtcgttgcaggccttattcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17141 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt1)
  source 1..1959: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17142 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt1)
  source 1..1959: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17143 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt2)
  source 1..1959: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17144 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt3)
  source 1..1959: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17145 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt4)
  source 1..1959: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17146 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt5)
  source 1..1959: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17147 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt6)
  source 1..1959: mol_type = other RNA
gggagactttcccattctgtagcagaatttggtgttgcctgtggtcttggtcccgcggagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17148 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut5 (opt11)
  source 1..1959: mol_type = other RNA
gggagactttcccattctgtagcagaatttggtgttgcctgtggtcttggtcccgcggagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17149 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt1)
  source 1..1955: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17150 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt1)
  source 1..1955: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17151 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt2)
  source 1..1955: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17152 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt3)
  source 1..1955: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17153 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt4)
  source 1..1955: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17154 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt5)
  source 1..1955: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17155 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt6)
  source 1..1955: mol_type = other RNA
gggagactttcccattctgtagcagaatttggtgttgcctgtggtcttggtcccgcggagaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17156 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut5 (opt11)
  source 1..1955: mol_type = other RNA
gggagactttcccattctgtagcagaatttggtgttgcctgtggtcttggtcccgcggagaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17157 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17158 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17159 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17160 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17161 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17162 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17163 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17164 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut5 (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17165 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17166 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17167 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt2)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17168 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt3)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17169 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt4)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17170 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt5)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17171 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt6)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17172 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut5 (opt11)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17173 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17174 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17175 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17176 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17177 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17178 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17179 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17180 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut5 (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17181 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17182 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17183 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17184 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17185 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17186 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17187 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17188 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut5 (opt11)
  source 1..1973: mol_type = other RNA
gggagacccgtgacccggaagttgtacggctacgcgactttccctcccacaaaccctcgcgcccttcctttcctacttgggcccggcagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17189 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17190 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17191 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt2)
  source 1..1989: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17192 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt3)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17193 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt4)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17194 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt5)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17195 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt6)
  source 1..1989: mol_type = other RNA
gggagacccgtgacccggaagttgtacggctacgcgactttccctcccacaaaccctcgcgcccttcctttcctacttgggcccggcagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17196 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut5 (opt11)
  source 1..1989: mol_type = other RNA
gggagacccgtgacccggaagttgtacggctacgcgactttccctcccacaaaccctcgcgcccttcctttcctacttgggcccggcagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17197 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17198 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17199 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt2)
  source 1..2205: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17200 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt3)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17201 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt4)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17202 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt5)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17203 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt6)
  source 1..2205: mol_type = other RNA
gggagacccgtgacccggaagttgtacggctacgcgactttccctcccacaaaccctcgcgcccttcctttcctacttgggcccggcagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17204 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut5 (opt11)
  source 1..2205: mol_type = other RNA
gggagacccgtgacccggaagttgtacggctacgcgactttccctcccacaaaccctcgcgcccttcctttcctacttgggcccggcagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17205 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17206 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17207 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt2)
  source 1..1985: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17208 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt3)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17209 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt4)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17210 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt5)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17211 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt6)
  source 1..1985: mol_type = other RNA
gggagacccgtgacccggaagttgtacggctacgcgactttccctcccacaaaccctcgcgcccttcctttcctacttgggcccggcagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17212 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut5 (opt11)
  source 1..1985: mol_type = other RNA
gggagacccgtgacccggaagttgtacggctacgcgactttccctcccacaaaccctcgcgcccttcctttcctacttgggcccggcagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17213 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17214 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17215 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17216 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17217 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17218 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17219 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17220 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut5 (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17221 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17222 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17223 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt2)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17224 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt3)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17225 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt4)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17226 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt5)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17227 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt6)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17228 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut5 (opt11)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17229 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17230 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17231 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17232 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17233 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17234 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17235 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17236 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut5 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17237 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt1)
  source 1..1997: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17238 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt1)
  source 1..1997: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17239 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt2)
  source 1..1997: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17240 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt3)
  source 1..1997: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17241 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt4)
  source 1..1997: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17242 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt5)
  source 1..1997: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17243 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt6)
  source 1..1997: mol_type = other RNA
gggagaggcgctgcctacggaggtggcagccatctccttctcggcatcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17244 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut5 (opt11)
  source 1..1997: mol_type = other RNA
gggagaggcgctgcctacggaggtggcagccatctccttctcggcatcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17245 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt1)
  source 1..1993: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17246 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt1)
  source 1..1993: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17247 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt2)
  source 1..1993: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17248 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt3)
  source 1..1993: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17249 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt4)
  source 1..1993: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17250 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt5)
  source 1..1993: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17251 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt6)
  source 1..1993: mol_type = other RNA
ggggcgctgcctacggaggtggcagccatctccttctcggcatcaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17252 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut5 (opt11)
  source 1..1993: mol_type = other RNA
ggggcgctgcctacggaggtggcagccatctccttctcggcatcaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17253 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt1)
  source 1..1828: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17254 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt1)
  source 1..1828: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17255 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt2)
  source 1..1828: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17256 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt3)
  source 1..1828: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgcagtacccccgtcacactgtctaaggaccagctcagcggcattaataacatcgctttctccaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17257 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt4)
  source 1..1828: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17258 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt5)
  source 1..1828: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatctacccccgtgacactttccaaggaccagctcagcgggatcaataacattgcgttctctaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17259 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt6)
  source 1..1828: mol_type = other RNA
gggagaaagcttaccatggaactcccaatcttaaaaacaaacgcaataactacaatactcgcagcagtaacactatgcttcgcatcatcacaaaacataaccgaagaattttaccaaagtacatgctcagcagtatcaaaaggttacctctcagccctaagaaccggatggtacacatcagtaatcactatagaactatccaatataaaagaaaacaaatgcaacggcactgacgcaaaagttaaattaattaaacaagaactcgataaatataaaaatgcagtaacagaactacaactactaatgcaaagcaccccagctgcaggaagcggatcagcaatcgcatcaggaatagcagtatgtaaagtactacacctagaaggagaagtcaacaaaatcaaaaatgcactactaagtacaaacaaagctgtagtaagcctatcaggttgcggagtatcagtattaacatttaaagtcctcgacctaaaaaattacatagataaacaactcttaccaatactcaataaacaaagttgcagcatcagcaacatagaaacagtcatcgaatttcaacaaaaaaataatagactcctagaaataacacgtgaattttcagtaaatgctggagtaacaacaccagtatctacatatatgctaacaaatagcgaactactctcacttattaacgatatgcccataacaaacgaccaaaaaaaacttatgtcaaacaatgttcaaatagttagacaacaatcctacagcataatgtgcataatcaaagaagaagttctagcttacgtagtacaactaccactctatggtgttatcgacaccccctgttggaaacttcacacatcaccactatgcacaacaaacacaaaagaaggatcaaatatttgcttaacaagaacagatagaggatggtattgcgataatgccggatcagtatcattttttccacaagcagaaacatgtaaagtacaatccaaccgagtattttgcgacaccatgaactccagaacactaccatctgaagtcaacctatgtaatatagatatatttaacccaaaatatgactgtaaaatcatgacatcaaaaactgatgtaagttctagtgtaataaccagcttaggcgccatagtaagctgttacggtaaaacaaaatgcacagcaagcaacaaatgccgcggtataataaaaacattctcaaacggatgcgattatgtaagtaacaaaggagtagatacagtctccgtaggcaacacattatactacgtaaacaaacaagaaggaaaatcactatatgtaaaaggagaaccaatcataaatttctacgacccacttgtattccccagcgacgaatttgatgcttccatttcacaagtcaacgaaaaaataaaccaatcattagccttcataagaaaatcagacgaattattacataatgttaatgtcggcaaatccacaactaatataatgataacaacaatcataatagtaataatcgttatactactattactcatagcagtaggactcttcttatattgtaaagccagatccaccccagtaacactctcaaaagaccaattatcaggaattaataacatcgcattttcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17260 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut5 (opt11)
  source 1..1828: mol_type = other RNA
gggagaaagcttaccatggaactccccatccttaaaaccaacgcaatcaccacaatactcgccgccgtcaccctctgctttgcgtcctcccagaacatcaccgaagagttctaccaatcgacctgcagcgccgtcagcaagggctacctctcagccctccgaacaggctggtacacatccgtcatcaccatcgaactctcaaacataaaagaaaacaagtgtaacggcaccgacgcgaaagttaaactcatcaaacaagaactcgataaatacaaaaacgcagtaaccgaactacaactcctaatgcaatccacacccgcagccggcagcggctccgcaatcgcctccggcatagcagtctgcaaagtcctccacctcgaaggagaagtcaataaaatcaaaaacgccctcctatccaccaacaaagcggttgtctccctgtccggatgcggagttagcgtcctaaccttcaaggtgctcgacctcaaaaactacatagacaaacaactactccccatactcaacaaacaatcatgctccatcagcaacatcgagaccgtcatcgagttccaacagaaaaacaaccgcctcctcgaaatcacacgagagttctccgtaaacgccggcgtcacaacccccgtttccacttacatgctcacaaacagcgaactcctctccctcatcaacgacatgccaatcaccaacgaccaaaagaaactcatgtccaacaacgtccaaatcgtccgccaacaaagctacagcataatgtgcatcataaaagaagaagtactcgcgtacgtagtccaactacccctatacggcgtcatcgacaccccctgctggaaactgcacacttctcccctctgtacaaccaacactaaagaaggctcgaacatctgcctcaccagaacagaccgaggatggtactgcgacaacgccggctccgtcagcttcttcccccaggccgaaacatgcaaagtacaatcaaaccgagtcttctgcgacacaatgaacagcagaactctaccctccgaagttaacctatgcaacatcgacatcttcaaccccaaatacgactgcaaaataatgacctcaaaaacagacgtgtccagctccgttatcacctctctcggagccatcgtatcctgttatggaaaaaccaaatgcaccgcctcaaacaaatgccgaggcataatcaaaacattctcaaatggatgcgactacgtatccaacaaaggagtcgacaccgtcagcgtgggcaataccctctactacgtcaacaaacaggaagggaaatccctctatgtaaagggcgagcccattattaacttctatgaccccctcgtgttcccaagcgacgagttcgacgcctccatatcacaagtcaatgagaaaatcaaccaatcactagctttcattcgcaaatccgacgaactccttcacaacgtcaacgtcggcaaatccaccaccaacatcatgatcaccaccataattatcgtcattatcgtcatactactcctactcatcgccgtcggcctcttcctctattgcaaagcacgctcgacacccgtcaccctttcaaaagaccaactttccggcataaacaacatagccttcagcaactagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17261 - protein, 515 aa, synthetic construct
  REGION 1..515: note = derived and/or modified protein sequence (artificial) from HRSV(Memphis-37)__AIY60640.1__F-del_DSCav1_mut5
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAAGSGSAIASGIAVCKVLHLEGEVNKIKNALLSTNKAVVSLSGCGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNIDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 17262 - RNA, 1548 nt, synthetic construct
  misc_feature 1..1548: note = derived and/or modified CDS sequence (opt1) from HRSV(Memphis-37)__AIY60640.1__F-del_DSCav1_mut5
  source 1..1548: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 17263 - RNA, 1548 nt, synthetic construct
  misc_feature 1..1548: note = derived and/or modified CDS sequence (opt1) from HRSV(Memphis-37)__AIY60640.1__F-del_DSCav1_mut5
  source 1..1548: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtga

SEQ ID NO: 17264 - RNA, 1548 nt, synthetic construct
  misc_feature 1..1548: note = derived and/or modified CDS sequence (opt2) from HRSV(Memphis-37)__AIY60640.1__F-del_DSCav1_mut5
  source 1..1548: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 17265 - RNA, 1548 nt, synthetic construct
  misc_feature 1..1548: note = derived and/or modified CDS sequence (opt3) from HRSV(Memphis-37)__AIY60640.1__F-del_DSCav1_mut5
  source 1..1548: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctga

SEQ ID NO: 17266 - RNA, 1548 nt, synthetic construct
  misc_feature 1..1548: note = derived and/or modified CDS sequence (opt4) from HRSV(Memphis-37)__AIY60640.1__F-del_DSCav1_mut5
  source 1..1548: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 17267 - RNA, 1548 nt, synthetic construct
  misc_feature 1..1548: note = derived and/or modified CDS sequence (opt5) from HRSV(Memphis-37)__AIY60640.1__F-del_DSCav1_mut5
  source 1..1548: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatga

SEQ ID NO: 17268 - RNA, 1548 nt, synthetic construct
  misc_feature 1..1548: note = derived and/or modified CDS sequence (opt6) from HRSV(Memphis-37)__AIY60640.1__F-del_DSCav1_mut5
  source 1..1548: mol_type = other RNA
atggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaa

SEQ ID NO: 17269 - RNA, 1548 nt, synthetic construct
  misc_feature 1..1548: note = derived and/or modified CDS sequence (opt11) from HRSV(Memphis-37)__AIY60640.1__F-del_DSCav1_mut5
  source 1..1548: mol_type = other RNA
atggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctag

SEQ ID NO: 17270 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt1)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17271 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt1)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17272 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt2)
  source 1..1824: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17273 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt3)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17274 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt4)
  source 1..1824: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17275 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt5)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17276 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt6)
  source 1..1824: mol_type = other RNA
gggagagtcccgcagtcggcgtccagcggctctgcttgttcgtgtgtgtgtcgttgcaggccttattcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17277 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut5 (opt11)
  source 1..1824: mol_type = other RNA
gggagagtcccgcagtcggcgtccagcggctctgcttgttcgtgtgtgtgtcgttgcaggccttattcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17278 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17279 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17280 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt2)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17281 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt3)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17282 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt4)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17283 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt5)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17284 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt6)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17285 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut5 (opt11)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17286 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17287 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17288 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt2)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17289 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt3)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17290 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt4)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17291 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt5)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17292 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt6)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17293 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut5 (opt11)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17294 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17295 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17296 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt2)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17297 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt3)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17298 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt4)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17299 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt5)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17300 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt6)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17301 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut5 (opt11)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17302 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt1)
  source 1..1816: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17303 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt1)
  source 1..1816: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17304 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt2)
  source 1..1816: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17305 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt3)
  source 1..1816: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17306 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt4)
  source 1..1816: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17307 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt5)
  source 1..1816: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17308 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt6)
  source 1..1816: mol_type = other RNA
gggagactttcccattctgtagcagaatttggtgttgcctgtggtcttggtcccgcggagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17309 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut5 (opt11)
  source 1..1816: mol_type = other RNA
gggagactttcccattctgtagcagaatttggtgttgcctgtggtcttggtcccgcggagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17310 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17311 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17312 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt2)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17313 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt3)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17314 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt4)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17315 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt5)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17316 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt6)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17317 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut5 (opt11)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17318 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt1)
  source 1..1817: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17319 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt1)
  source 1..1817: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17320 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt2)
  source 1..1817: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17321 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt3)
  source 1..1817: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17322 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt4)
  source 1..1817: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17323 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt5)
  source 1..1817: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17324 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt6)
  source 1..1817: mol_type = other RNA
gggagagcctctgctggagtccggggagtggcgttggctgctagagcgaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17325 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut5 (opt11)
  source 1..1817: mol_type = other RNA
gggagagcctctgctggagtccggggagtggcgttggctgctagagcgaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17326 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt1)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17327 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt1)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17328 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt2)
  source 1..1837: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17329 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt3)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17330 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt4)
  source 1..1837: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17331 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt5)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17332 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt6)
  source 1..1837: mol_type = other RNA
gggagagtcccgcagtcggcgtccagcggctctgcttgttcgtgtgtgtgtcgttgcaggccttattcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17333 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut5 (opt11)
  source 1..1837: mol_type = other RNA
gggagagtcccgcagtcggcgtccagcggctctgcttgttcgtgtgtgtgtcgttgcaggccttattcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17334 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt1)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17335 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt1)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17336 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt2)
  source 1..1888: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17337 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt3)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17338 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt4)
  source 1..1888: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17339 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt5)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17340 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt6)
  source 1..1888: mol_type = other RNA
gggagagtcccgcagtcggcgtccagcggctctgcttgttcgtgtgtgtgtcgttgcaggccttattcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17341 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut5 (opt11)
  source 1..1888: mol_type = other RNA
gggagagtcccgcagtcggcgtccagcggctctgcttgttcgtgtgtgtgtcgttgcaggccttattcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17342 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17343 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17344 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt2)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17345 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt3)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17346 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt4)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17347 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt5)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17348 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt6)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17349 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut5 (opt11)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17350 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17351 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17352 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt2)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17353 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt3)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17354 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt4)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17355 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt5)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17356 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt6)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17357 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut5 (opt11)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17358 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17359 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17360 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17361 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17362 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17363 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17364 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17365 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut5 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17366 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17367 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17368 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt2)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17369 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt3)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17370 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt4)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17371 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt5)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17372 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt6)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17373 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut5 (opt11)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17374 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17375 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17376 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17377 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17378 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17379 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17380 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17381 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut5 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17382 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt1)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17383 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt1)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17384 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt2)
  source 1..1837: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17385 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt3)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17386 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt4)
  source 1..1837: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17387 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt5)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17388 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt6)
  source 1..1837: mol_type = other RNA
gggagagcggctcggccattttgtcccagtcagtccggaggctgcggctgcagaagtaccgcctgcggagtaactgcaaagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17389 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut5 (opt11)
  source 1..1837: mol_type = other RNA
gggagagcggctcggccattttgtcccagtcagtccggaggctgcggctgcagaagtaccgcctgcggagtaactgcaaagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17390 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17391 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17392 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt2)
  source 1..1846: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17393 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt3)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17394 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt4)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17395 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt5)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17396 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt6)
  source 1..1846: mol_type = other RNA
gggagacccgtgacccggaagttgtacggctacgcgactttccctcccacaaaccctcgcgcccttcctttcctacttgggcccggcagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17397 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut5 (opt11)
  source 1..1846: mol_type = other RNA
gggagacccgtgacccggaagttgtacggctacgcgactttccctcccacaaaccctcgcgcccttcctttcctacttgggcccggcagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17398 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt1)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17399 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt1)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17400 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt2)
  source 1..1901: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17401 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt3)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17402 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt4)
  source 1..1901: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17403 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt5)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17404 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt6)
  source 1..1901: mol_type = other RNA
gggagagcggctcggccattttgtcccagtcagtccggaggctgcggctgcagaagtaccgcctgcggagtaactgcaaagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17405 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut5 (opt11)
  source 1..1901: mol_type = other RNA
gggagagcggctcggccattttgtcccagtcagtccggaggctgcggctgcagaagtaccgcctgcggagtaactgcaaagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17406 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17407 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17408 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt2)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17409 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt3)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17410 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt4)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17411 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt5)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17412 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt6)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17413 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut5 (opt11)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17414 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17415 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17416 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt2)
  source 1..1900: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17417 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt3)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17418 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt4)
  source 1..1900: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17419 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt5)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17420 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt6)
  source 1..1900: mol_type = other RNA
gggagagtcccgcagtcggcgtccagcggctctgcttgttcgtgtgtgtgtcgttgcaggccttattcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17421 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut5 (opt11)
  source 1..1900: mol_type = other RNA
gggagagtcccgcagtcggcgtccagcggctctgcttgttcgtgtgtgtgtcgttgcaggccttattcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17422 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17423 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17424 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17425 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17426 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17427 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17428 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17429 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut5 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17430 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17431 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17432 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt2)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17433 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt3)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17434 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt4)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17435 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt5)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17436 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt6)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17437 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut5 (opt11)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17438 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17439 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17440 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt2)
  source 1..1859: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17441 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt3)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17442 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt4)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17443 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt5)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17444 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt6)
  source 1..1859: mol_type = other RNA
gggagacccgtgacccggaagttgtacggctacgcgactttccctcccacaaaccctcgcgcccttcctttcctacttgggcccggcagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17445 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut5 (opt11)
  source 1..1859: mol_type = other RNA
gggagacccgtgacccggaagttgtacggctacgcgactttccctcccacaaaccctcgcgcccttcctttcctacttgggcccggcagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17446 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt1)
  source 1..1829: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17447 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt1)
  source 1..1829: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17448 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt2)
  source 1..1829: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17449 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt3)
  source 1..1829: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17450 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt4)
  source 1..1829: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17451 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt5)
  source 1..1829: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17452 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt6)
  source 1..1829: mol_type = other RNA
gggagactttcccattctgtagcagaatttggtgttgcctgtggtcttggtcccgcggagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17453 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut5 (opt11)
  source 1..1829: mol_type = other RNA
gggagactttcccattctgtagcagaatttggtgttgcctgtggtcttggtcccgcggagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17454 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17455 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17456 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt2)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17457 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt3)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17458 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt4)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17459 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt5)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17460 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt6)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17461 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut5 (opt11)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17462 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt1)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17463 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt1)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17464 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt2)
  source 1..1850: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17465 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt3)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17466 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt4)
  source 1..1850: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17467 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt5)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17468 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt6)
  source 1..1850: mol_type = other RNA
gggagagcggctcggccattttgtcccagtcagtccggaggctgcggctgcagaagtaccgcctgcggagtaactgcaaagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17469 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut5 (opt11)
  source 1..1850: mol_type = other RNA
gggagagcggctcggccattttgtcccagtcagtccggaggctgcggctgcagaagtaccgcctgcggagtaactgcaaagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17470 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt1)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17471 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt1)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17472 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt2)
  source 1..1917: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17473 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt3)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17474 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt4)
  source 1..1917: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17475 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt5)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17476 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt6)
  source 1..1917: mol_type = other RNA
gggagagcggctcggccattttgtcccagtcagtccggaggctgcggctgcagaagtaccgcctgcggagtaactgcaaagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17477 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut5 (opt11)
  source 1..1917: mol_type = other RNA
gggagagcggctcggccattttgtcccagtcagtccggaggctgcggctgcagaagtaccgcctgcggagtaactgcaaagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17478 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt1)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17479 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt1)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17480 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt2)
  source 1..2133: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17481 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt3)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17482 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt4)
  source 1..2133: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17483 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt5)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17484 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt6)
  source 1..2133: mol_type = other RNA
gggagagcggctcggccattttgtcccagtcagtccggaggctgcggctgcagaagtaccgcctgcggagtaactgcaaagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17485 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut5 (opt11)
  source 1..2133: mol_type = other RNA
gggagagcggctcggccattttgtcccagtcagtccggaggctgcggctgcagaagtaccgcctgcggagtaactgcaaagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17486 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17487 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17488 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt2)
  source 1..1913: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17489 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt3)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17490 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt4)
  source 1..1913: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17491 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt5)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17492 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt6)
  source 1..1913: mol_type = other RNA
gggagagcggctcggccattttgtcccagtcagtccggaggctgcggctgcagaagtaccgcctgcggagtaactgcaaagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17493 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut5 (opt11)
  source 1..1913: mol_type = other RNA
gggagagcggctcggccattttgtcccagtcagtccggaggctgcggctgcagaagtaccgcctgcggagtaactgcaaagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17494 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt1)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17495 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt1)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17496 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt2)
  source 1..1904: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17497 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt3)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17498 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt4)
  source 1..1904: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17499 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt5)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17500 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt6)
  source 1..1904: mol_type = other RNA
gggagagtcccgcagtcggcgtccagcggctctgcttgttcgtgtgtgtgtcgttgcaggccttattcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17501 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut5 (opt11)
  source 1..1904: mol_type = other RNA
gggagagtcccgcagtcggcgtccagcggctctgcttgttcgtgtgtgtgtcgttgcaggccttattcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17502 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt1)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17503 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt1)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17504 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt2)
  source 1..2120: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17505 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt3)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17506 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt4)
  source 1..2120: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17507 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt5)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17508 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt6)
  source 1..2120: mol_type = other RNA
gggagagtcccgcagtcggcgtccagcggctctgcttgttcgtgtgtgtgtcgttgcaggccttattcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17509 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut5 (opt11)
  source 1..2120: mol_type = other RNA
gggagagtcccgcagtcggcgtccagcggctctgcttgttcgtgtgtgtgtcgttgcaggccttattcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17510 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt1)
  source 1..1896: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17511 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt1)
  source 1..1896: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17512 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt2)
  source 1..1896: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17513 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt3)
  source 1..1896: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17514 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt4)
  source 1..1896: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17515 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt5)
  source 1..1896: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17516 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt6)
  source 1..1896: mol_type = other RNA
gggagactttcccattctgtagcagaatttggtgttgcctgtggtcttggtcccgcggagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17517 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut5 (opt11)
  source 1..1896: mol_type = other RNA
gggagactttcccattctgtagcagaatttggtgttgcctgtggtcttggtcccgcggagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17518 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17519 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17520 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt2)
  source 1..1892: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17521 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt3)
  source 1..1892: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17522 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt4)
  source 1..1892: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17523 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt5)
  source 1..1892: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17524 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt6)
  source 1..1892: mol_type = other RNA
gggagactttcccattctgtagcagaatttggtgttgcctgtggtcttggtcccgcggagaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17525 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut5 (opt11)
  source 1..1892: mol_type = other RNA
gggagactttcccattctgtagcagaatttggtgttgcctgtggtcttggtcccgcggagaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17526 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17527 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17528 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt2)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17529 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt3)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17530 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt4)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17531 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt5)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17532 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt6)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17533 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut5 (opt11)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17534 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17535 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17536 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt2)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17537 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt3)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17538 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt4)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17539 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt5)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17540 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt6)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17541 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut5 (opt11)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17542 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17543 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17544 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt2)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17545 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt3)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17546 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt4)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17547 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt5)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17548 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt6)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17549 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut5 (opt11)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17550 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17551 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17552 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt2)
  source 1..1910: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17553 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt3)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17554 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt4)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17555 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt5)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17556 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt6)
  source 1..1910: mol_type = other RNA
gggagacccgtgacccggaagttgtacggctacgcgactttccctcccacaaaccctcgcgcccttcctttcctacttgggcccggcagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17557 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut5 (opt11)
  source 1..1910: mol_type = other RNA
gggagacccgtgacccggaagttgtacggctacgcgactttccctcccacaaaccctcgcgcccttcctttcctacttgggcccggcagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17558 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17559 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17560 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt2)
  source 1..1926: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17561 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt3)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17562 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt4)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17563 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt5)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17564 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt6)
  source 1..1926: mol_type = other RNA
gggagacccgtgacccggaagttgtacggctacgcgactttccctcccacaaaccctcgcgcccttcctttcctacttgggcccggcagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17565 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut5 (opt11)
  source 1..1926: mol_type = other RNA
gggagacccgtgacccggaagttgtacggctacgcgactttccctcccacaaaccctcgcgcccttcctttcctacttgggcccggcagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17566 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17567 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17568 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt2)
  source 1..2142: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17569 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt3)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17570 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt4)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17571 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt5)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17572 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt6)
  source 1..2142: mol_type = other RNA
gggagacccgtgacccggaagttgtacggctacgcgactttccctcccacaaaccctcgcgcccttcctttcctacttgggcccggcagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17573 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut5 (opt11)
  source 1..2142: mol_type = other RNA
gggagacccgtgacccggaagttgtacggctacgcgactttccctcccacaaaccctcgcgcccttcctttcctacttgggcccggcagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17574 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17575 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17576 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17577 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17578 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17579 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17580 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17581 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut5 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17582 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17583 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17584 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt2)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17585 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt3)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17586 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt4)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17587 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt5)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17588 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt6)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17589 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut5 (opt11)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17590 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17591 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17592 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt2)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17593 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt3)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17594 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt4)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17595 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt5)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17596 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt6)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17597 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut5 (opt11)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17598 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17599 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17600 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt2)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17601 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt3)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17602 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt4)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17603 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt5)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17604 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt6)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17605 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut5 (opt11)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17606 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt1)
  source 1..1934: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17607 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt1)
  source 1..1934: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17608 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt2)
  source 1..1934: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17609 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt3)
  source 1..1934: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17610 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt4)
  source 1..1934: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17611 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt5)
  source 1..1934: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17612 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt6)
  source 1..1934: mol_type = other RNA
gggagaggcgctgcctacggaggtggcagccatctccttctcggcatcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17613 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut5 (opt11)
  source 1..1934: mol_type = other RNA
gggagaggcgctgcctacggaggtggcagccatctccttctcggcatcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17614 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt1)
  source 1..1930: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17615 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt1)
  source 1..1930: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17616 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt2)
  source 1..1930: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17617 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt3)
  source 1..1930: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17618 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt4)
  source 1..1930: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17619 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt5)
  source 1..1930: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17620 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt6)
  source 1..1930: mol_type = other RNA
ggggcgctgcctacggaggtggcagccatctccttctcggcatcaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17621 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut5 (opt11)
  source 1..1930: mol_type = other RNA
ggggcgctgcctacggaggtggcagccatctccttctcggcatcaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17622 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt1)
  source 1..1765: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17623 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt1)
  source 1..1765: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17624 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt2)
  source 1..1765: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17625 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt3)
  source 1..1765: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcggctgcggtgtctccgtgttaacgttcaaggtactggaccttaagaattacatcgataaacaattgctgccaattctaaacaagcagtcatgtagtatcagcaatatagagactgttattgaatttcagcagaaaaacaataggctcctggagatcacccgggagttctctgtgaacgcaggggtcacaactccggtgtccacctatatgcttacaaattcagaactgttgagcctcattaacgacatgcccatcaccaacgatcaaaagaaactgatgagtaataacgtgcagatcgtccgccagcagtcttactccattatgtgcataatcaaggaggaagttttagcctatgtggtacaactgcctctctacggagtgattgacacgccatgttggaaacttcatactagccccctgtgcacaaccaatactaaggagggctcgaacatctgtttgacacgaaccgatcgtggctggtactgcgacaatgctgggtctgtctcctttttccctcaggccgaaacgtgtaaggtgcagtcaaacagagtgttttgcgataccatgaatagtagaacactgccaagcgaggtgaacctctgcaatatagacattttcaaccccaaatatgattgtaagatcatgacttccaaaaccgacgtctctagctcagtgatcacaagtctgggagcaattgtatcctgctacggtaagactaaatgtaccgctagcaataagtgcaggggcatcattaagacattttctaacgggtgtgattatgtttcaaataaaggagtggacaccgtcagtgtgggcaacactctttactatgtcaataagcaagagggtaaaagcctgtacgtgaagggggaacctataatcaacttctatgacccattggtttttccgtccgatgagttcgacgcctctatttcgcaggttaacgagaaaatcaatcagagcctcgcgtttatccggaagtccgatgaactgttacacaacgtaaatgtcggaaagtcaacgacaaacattatgataaccactatcattatcgtgattatcgttatactgctactcctgatcgccgtgggccttttcttgtactgcaaagcacgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17626 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt4)
  source 1..1765: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17627 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt5)
  source 1..1765: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcgggtgcggagtgtctgttctgaccttcaaggtgcttgacctgaagaattacatcgataaacaactcctgccgattctgaacaagcagtcctgtagcatctctaatattgagacagtcatcgaatttcagcagaaaaacaatcggctcctggagatcacccgcgagttctccgtgaacgctggcgtgacgacacccgtcagcacctatatgcttacaaattccgaactgctctctctgattaacgacatgcctatcaccaacgatcaaaagaaacttatgagcaataacgttcagattgtgagacagcagtcctacagcatcatgtgcattatcaaggaggaagtgctggcctatgtcgtgcaactccccctgtacggcgttatcgacaccccttgttggaaactgcatacatctcccctctgcacgaccaatacaaaggaggggtccaacatttgtctgacccggacagatcgcggatggtactgcgacaatgcgggcagcgtgagctttttccctcaggccgaaacctgtaaggtccagtctaacagagtgttttgcgatacgatgaactccagaacactgccgtctgaggttaatctctgcaatatcgacattttcaaccccaaatatgattgtaagatcatgaccagcaaaaccgacgtgtccagctctgtcattacatccctgggggctatcgtgagctgctacggaaagaccaaatgtacagcctctaataagtgccggggcatcattaagacgttttccaacgggtgtgattatgtcagcaataaaggagtggacaccgtttccgtgggcaacacactttactatgtcaataagcaagagggcaaatctctgtacgtgaagggggaacctatcattaacttctatgaccccctcgtttttcctagcgatgagttcgacgcttccatctctcaggtgaacgagaaaattaatcagagcctggcctttatccgcaagtccgatgaactgctccacaacgtcaatgtgggaaagagcaccacaaacattatgatcaccacgatcattatcgtgattatcgttattctgcttctgctcatcgccgtcggcctgttcctgtactgcaaagctagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17628 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt6)
  source 1..1765: mol_type = other RNA
gggagaaagcttaccatggaattacccatcttaaaaacaaatgcaataacaacaatactagcagccgtaacattatgcttcgcctcaagccaaaacataacagaagaattttaccaaagcacatgttccgccgtatcaaaaggatatctctcagcactacgtactggatggtatacatccgtaatcacaattgaactatcaaacattaaagaaaacaaatgcaatggaacagatgcgaaagtaaaactaataaaacaagaattagataaatataaaaatgcagtaaccgaactacaactactaatgcaatcaactcccgctgccggtagcggatccgccatagcaagcggaattgctgtatgtaaagtcctacatcttgaaggcgaagtcaacaaaatcaaaaatgcattactctcgaccaacaaagcagtcgtatcactatcaggatgcggagtctcagtattaacttttaaagtccttgacctaaaaaactacatagacaaacaactactaccaattctaaataaacaaagttgcagcatatccaatatcgaaacagttatagaatttcaacaaaaaaacaaccgcctactagaaatcactagagaattttcagtaaatgcaggcgtaaccacaccagtctctacctatatgcttaccaactctgaattattatcacttataaacgacatgcccataacaaatgatcaaaaaaaactaatgagcaacaacgtacaaatagtaagacaacaaagctacagcattatgtgtataataaaagaagaagtgttagcttatgtagtccaactacccctctatggcgttatcgatacaccatgctggaaattacacacaagccctctatgcacaactaacaccaaagaaggctctaacatatgcttaacaagaacagatagaggatggtattgcgataacgcaggatcagtatcattctttccacaagcagaaacatgtaaagtacaatctaaccgagtattctgcgacacaatgaactctagaacactaccctcagaagttaatctctgtaatattgacattttcaatccaaaatacgattgcaaaataatgacctctaaaaccgacgtatcatcctcagttataacgtccttaggagcaatcgtaagctgctatggcaaaacaaaatgtaccgcatcaaacaaatgcagaggaataataaaaacattctcaaacggctgtgactacgtaagcaataaaggtgttgacacagtttcagtaggaaatacactatactatgtaaataaacaagaaggaaaatctctctatgtaaaaggagaacccataataaacttctacgacccactcgtatttccaagcgatgaatttgatgcgagcatttcccaggtaaatgaaaaaataaatcaatcactagcattcatcagaaaaagtgatgaattactacacaatgttaacgtaggaaaatcaacaacaaatatcatgataacaacaatcataatagtcataatcgtaatattactattactaatagcagtaggtttatttctatactgtaaagcaaggtaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17629 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut5 (opt11)
  source 1..1765: mol_type = other RNA
gggagaaagcttaccatggaacttcccatcctaaaaaccaacgccataacaacaatcctcgcagcagtcaccctctgcttcgcctcttcacaaaacatcaccgaagaattttaccaatcaacctgctccgccgtgtccaaaggctacctctcagcactgcgcacaggatggtataccagcgtaatcaccatcgaactctccaacatcaaggaaaacaaatgcaacggcaccgatgccaaagtcaaactcatcaagcaagaacttgacaaatacaaaaacgccgtgaccgagctacaactcctcatgcagtccactccagccgccggctccggcagcgccatcgcctccggcatcgccgtatgcaaagtcctccacctcgaaggcgaagtaaacaaaatcaagaacgcactcctaagcaccaacaaagccgtcgtctcactctccggttgcggcgtcagcgtcctaacattcaaagttctcgacctcaaaaactacatagacaaacaactcctccccatcctcaacaaacaatcctgctccatatcaaacatcgaaaccgttatcgaatttcaacaaaaaaacaaccgcctcctagaaatcacccgcgaattttccgtcaacgcaggcgtcaccacccccgtttccacctatatgctcaccaactccgaactcctctccctcatcaacgacatgcccattaccaacgaccaaaagaaacttatgagcaacaacgttcaaatcgtccgacaacaatcatactccatcatgtgcattatcaaagaagaagtactcgcctacgtagtacaattacccctctacggcgtaatcgacaccccatgctggaaactacacacctcccccctctgtaccaccaacaccaaagaaggctctaacatctgcctcacccgcacagaccgtggctggtattgcgataacgcagggtctgtctccttcttcccccaagccgaaacatgcaaagtccaatccaacagagtcttctgcgacaccatgaactcgagaaccctcccctccgaagtcaacctatgcaacatcgacatcttcaacccaaaatacgactgcaaaatcatgacttcaaaaacagacgtgagctcgtccgtcatcacaagcctaggagctatcgtatcctgctacggaaaaacaaaatgcactgcttccaacaaatgccgcggaatcataaaaaccttctccaacggctgcgactacgtcagcaacaaaggcgtcgacacagtctccgtaggcaacaccctatactacgtcaataaacaagaaggcaagtccctatatgtcaaaggcgagcccatcatcaatttctatgatcccctcgttttcccatccgacgaatttgacgcatccatctcccaagtcaacgaaaaaataaaccaaagcctcgcattcatccgcaaatccgacgaactcctccacaacgtaaacgtaggaaaatccacaactaacatcatgatcaccaccatcatcatcgtcattatcgtcatcctactcctcctcatagcagtcggcctcttcctctactgcaaagcacgctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17630 - protein, 535 aa, synthetic construct
  REGION 1..535: note = derived and/or modified protein sequence (artificial) from HRSV(Memphis-37)__AIY60640.1__F_DSCav1_mut6
MELPILKTNAITTILAAVTLCFASSQNITEEFYQSTCSAVSKGYLGALRTGWYTSVITIELSNIKENKCNGTDAKVKLIKQELDKYKNAVTDLQMLMCSTPAAGSGSAIASGIAVCKVLHLEGEVNKIKNALLSTNKAVVSLSNGVSVLTFKVLDLKNYIDKQLLPILNKQSCSIPNPETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNIDIFNPKYDCKIMTSKTDVSSSVITSLGAIVSCYGKTKCTASNKNKGIIKTFSNGCDYVSNKGVDTVSVGNTLYYVNKQEGQSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 17631 - RNA, 1608 nt, synthetic construct
  misc_feature 1..1608: note = derived and/or modified CDS sequence (opt1) from HRSV(Memphis-37)__AIY60640.1__F_DSCav1_mut6
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 17632 - RNA, 1608 nt, synthetic construct
  misc_feature 1..1608: note = derived and/or modified CDS sequence (opt1) from HRSV(Memphis-37)__AIY60640.1__F_DSCav1_mut6
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactga

SEQ ID NO: 17633 - RNA, 1608 nt, synthetic construct
  misc_feature 1..1608: note = derived and/or modified CDS sequence (opt2) from HRSV(Memphis-37)__AIY60640.1__F_DSCav1_mut6
  source 1..1608: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 17634 - RNA, 1608 nt, synthetic construct
  misc_feature 1..1608: note = derived and/or modified CDS sequence (opt3) from HRSV(Memphis-37)__AIY60640.1__F_DSCav1_mut6
  source 1..1608: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattga

SEQ ID NO: 17635 - RNA, 1608 nt, synthetic construct
  misc_feature 1..1608: note = derived and/or modified CDS sequence (opt4) from HRSV(Memphis-37)__AIY60640.1__F_DSCav1_mut6
  source 1..1608: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 17636 - RNA, 1608 nt, synthetic construct
  misc_feature 1..1608: note = derived and/or modified CDS sequence (opt5) from HRSV(Memphis-37)__AIY60640.1__F_DSCav1_mut6
  source 1..1608: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattga

SEQ ID NO: 17637 - RNA, 1608 nt, synthetic construct
  misc_feature 1..1608: note = derived and/or modified CDS sequence (opt6) from HRSV(Memphis-37)__AIY60640.1__F_DSCav1_mut6
  source 1..1608: mol_type = other RNA
atggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaa

SEQ ID NO: 17638 - RNA, 1608 nt, synthetic construct
  misc_feature 1..1608: note = derived and/or modified CDS sequence (opt11) from HRSV(Memphis-37)__AIY60640.1__F_DSCav1_mut6
  source 1..1608: mol_type = other RNA
atggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactga

SEQ ID NO: 17639 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17640 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17641 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt2)
  source 1..1884: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17642 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt3)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17643 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt4)
  source 1..1884: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17644 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt5)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17645 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt6)
  source 1..1884: mol_type = other RNA
gggagagtcccgcagtcggcgtccagcggctctgcttgttcgtgtgtgtgtcgttgcaggccttattcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17646 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut6 (opt11)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17647 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17648 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17649 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17650 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17651 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17652 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17653 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17654 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut6 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17655 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17656 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17657 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17658 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17659 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17660 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17661 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17662 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut6 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17663 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17664 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17665 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17666 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17667 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17668 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17669 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17670 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut6 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17671 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17672 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17673 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt2)
  source 1..1876: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17674 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt3)
  source 1..1876: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17675 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt4)
  source 1..1876: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17676 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt5)
  source 1..1876: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17677 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt6)
  source 1..1876: mol_type = other RNA
gggagactttcccattctgtagcagaatttggtgttgcctgtggtcttggtcccgcggagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17678 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut6 (opt11)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17679 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17680 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17681 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17682 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17683 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17684 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17685 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17686 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut6 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17687 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17688 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17689 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt2)
  source 1..1877: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17690 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt3)
  source 1..1877: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17691 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt4)
  source 1..1877: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17692 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt5)
  source 1..1877: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17693 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt6)
  source 1..1877: mol_type = other RNA
gggagagcctctgctggagtccggggagtggcgttggctgctagagcgaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17694 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut6 (opt11)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17695 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17696 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17697 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17698 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17699 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17700 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17701 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt6)
  source 1..1897: mol_type = other RNA
gggagagtcccgcagtcggcgtccagcggctctgcttgttcgtgtgtgtgtcgttgcaggccttattcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17702 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut6 (opt11)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17703 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17704 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17705 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt2)
  source 1..1948: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17706 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt3)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17707 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt4)
  source 1..1948: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17708 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt5)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17709 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt6)
  source 1..1948: mol_type = other RNA
gggagagtcccgcagtcggcgtccagcggctctgcttgttcgtgtgtgtgtcgttgcaggccttattcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17710 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut6 (opt11)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17711 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17712 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17713 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17714 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17715 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17716 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17717 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17718 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut6 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17719 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17720 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17721 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17722 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17723 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17724 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17725 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17726 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut6 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17727 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17728 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17729 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17730 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17731 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17732 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17733 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17734 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut6 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17735 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17736 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17737 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17738 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17739 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17740 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17741 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17742 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut6 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17743 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17744 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17745 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17746 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17747 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17748 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17749 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17750 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut6 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17751 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17752 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17753 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt2)
  source 1..1897: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17754 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt3)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17755 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt4)
  source 1..1897: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17756 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt5)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17757 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt6)
  source 1..1897: mol_type = other RNA
gggagagcggctcggccattttgtcccagtcagtccggaggctgcggctgcagaagtaccgcctgcggagtaactgcaaagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17758 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut6 (opt11)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17759 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17760 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17761 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17762 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17763 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17764 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17765 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17766 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut6 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17767 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17768 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17769 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt2)
  source 1..1961: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17770 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt3)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17771 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt4)
  source 1..1961: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17772 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt5)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17773 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt6)
  source 1..1961: mol_type = other RNA
gggagagcggctcggccattttgtcccagtcagtccggaggctgcggctgcagaagtaccgcctgcggagtaactgcaaagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17774 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut6 (opt11)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17775 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17776 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17777 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17778 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17779 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17780 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17781 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17782 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut6 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17783 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17784 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17785 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt2)
  source 1..1960: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17786 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt3)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17787 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt4)
  source 1..1960: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17788 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt5)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17789 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt6)
  source 1..1960: mol_type = other RNA
gggagagtcccgcagtcggcgtccagcggctctgcttgttcgtgtgtgtgtcgttgcaggccttattcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17790 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut6 (opt11)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17791 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17792 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17793 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17794 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17795 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17796 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17797 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17798 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut6 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17799 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17800 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17801 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17802 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17803 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17804 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17805 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17806 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut6 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17807 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17808 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17809 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17810 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17811 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17812 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17813 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17814 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut6 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17815 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17816 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17817 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17818 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17819 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17820 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17821 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt6)
  source 1..1889: mol_type = other RNA
gggagactttcccattctgtagcagaatttggtgttgcctgtggtcttggtcccgcggagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17822 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut6 (opt11)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17823 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
